United States Patent 7,018,794 (METHODS FOR MONITORING MULTIPLE GENE EXPRESSION) - sequence listing, part 3

SEQ ID NO: 8317 - DNA, 959 bp, Bacillus clausii
gtgaaaaagcggtcgcttgaaaagaagtttatcctatatgtaggcgggctcattacactgattatggtgctcgtcacagcggtatatgtctatttagaacgaaaccaggcgcgccagcttattggcgaacaagcgttgacgactgccaaagccgttgcagaaattccagacgtgaaaaacgcgttggagacaggggcgagcacagacgagcttcagaagttgattggtgctatccaaaaacgggcagatgcagaatatattgtggtgggtgatgagaatggcatccgcttgacccatccagaccaggaaaaaatcggcatgccaatggtaggcggagacaacgaacaggcgcttgtttatggaaatagctacatttcgttggcggatggttctcttggcactgcggtgcgggggaagacgcctgtttttaatgaagaaggcgacgtcattggcgttgtatcagtaggatttatgatcggctatatcgattccatctttaaacagggtatggttgtatttttaatttggctgctgttgatttttttagtcggaattgcaggaagcacagcgttggcgcgaagcatccgcaacgacacgtttgggcttgaaccttaccaaattgccagactctataaagaacgccaagcggtgttccaatcgattaaagaaggattgattgcaacggaccaaaaagggattgtcacgcttgtcaatcagtcggcgacagatttgctacaaattgaagatgatgcagtcgggaagccagtcgaaacggtgcttacacaatcagaaatggctgcggtcttaaaagagcagcaccgtaaagggccacacgaagcgatttttcgcgataaacggctaattgtccattacaaaacaattgaagagaacggggagtatggcggaaaagttgccagtttccaagaccgttctgaactatacgagctgattaatgctct

SEQ ID NO: 8318 - DNA, 576 bp, Bacillus clausii
aggattttattcaactctattcggaaattggtgagttgagtgcaagccagatcgacctcatgaatatagaattggagcgaattgaaaacattattaatgactatgtgctgttagctgaagaacctcctgcccgagaaaacgaatcgattcaaatggcagcctttttgcagtcgctcttaaaaaagaacaaagtgaagcagcttaccgacggtcaccctattaagctaaacattaacgaggaagcaaccgtgttggggtcaagaaaagagctttttctattgttttacaacttgctagaaaatgcgattgatgctagtttgaaacattcgcctgtgcatattaatatgtatgcggaaggcgcaaatgtttgtgtggaaataacagactttggttcaggaattccagcggagagactccattatattggccagcccttttactcgacaaaagaaaaaggaacaggccttggcttaatgatttgttatcgtgtagccgaaacgcatggcggcctgatcgacatcgagtcgaaaaataaaaaaggaacgaatgtaaaagtcatcttgccaatgacaacga

SEQ ID NO: 8319 - DNA, 927 bp, Bacillus clausii
ggcatttttatctcgggcgacaggtattgcgatggtgttgacgttcttagtggtcattctactggcccgaacgatcacgatgccgattcttgacatgcgtcggcaagcgctccgcatgagccatggcgatttttcgaggcaagtccgtgtctacagtaccgatgagttaggccagcttgccactgcgtttaacgagttgacgaataggctccatgatacgacattaatgagggacagggagcagaagcgtttgcgttcggtattggcccacatgacggatggcgtgattgcgacagaccaaagcggcttaattattttgatgaaccgccgcgccgaagaactgttaggcattccgttaaagcatgtgctgcgcaggccgattatgaacgtgctgcgcatggaagaggaagtgagcatttttgagctctacgaaaggaacgagccgttgctccttgacttaagcacaggcgaagagccgattgtgctcgaagtgaacttttcagcgattcaagaagatgaaggccccttcaatggcttgattgcggtccttcacgatgtaaccgagaaagagaaaattgaaaatgaacggcgcgaatttgtcgccaacgtgtcacatgaattgcggacgccgttgacgacgatgaaaagctacctagaagcgttggcagacggggcgatgcaagatgaggacaatgcgccgcgctttttagaggtaacgcaaaaggaaacggaccggatgatccgccttgtcaatgatttgctccagctgtccaaaattgactcaaacgattaccgtctcgacttgcattgggtggagctcggtgcctttttgcatagcattgtcgaacggtttgaaatggtcgtcaaggacaaaaacattgattttcaccgccatattgcgaaacagccaacttacgtcaaaatcga

SEQ ID NO: 8320 - DNA, 393 bp, Bacillus clausii
  misc_feature (1)...(393): n = A,T,C or G
tagcgctatatcggtatctgtatttctgattataagaaaggaaagaagaatcgaagctgcctttgcagattttttgttagaaccgaatgaggcaaacgaagaaatgttatgccgggtatctccganaacaaattggccatttatccgcagaattggaagtgttctaaggtcctaccaagaggaacgaaatcaacaagtgcttgagctcgccgattatgaaaactacattgaaggttgggttcatgaaatgaaaaaacctttgtcattgatgacattggttttagataaccgcaatgacgaaatgtctcccctcgttcgacagcgtatgcttcatgtcagagatcaaatgcntggagatgtcgagcgaattttatattatgccagacttggagc

SEQ ID NO: 8321 - DNA, 840 bp, Bacillus clausii
ctttattaaagcgatggatatcccttacttaaaggtagacgagtgctttcgacagctccactggagcgaatcctttgttcatctcactgatttggcagaaaaagaccttgaagaacaaacactggcagagttaggcgtttctgatcatttgctgcattttattaatgaacaattaagcatttcagtcgggcgaggcaaccaaattgttaaaaactgttatgaagatgacgatgctacgatcaaagtgactgtatttcctgagagagggacatatgcttttgtgtactatgtgcttttagaagacttgacggtaaaacgaaaattcgaggaattagtcacatttcaacatcaaatgcaggcagtatcgcatattgctgccagtgtcgcccacgaactccggaacccgttgtctgtcataaaggggtttttgcaattatcccatttgacgagcgattttcagaagtattacaatacgattatttcagagctaaaccgtatgaatgtcattattgaagattttctatcggtttcacgcaaaaagaacgaccgtaaatggcaatcgccagcacagttgctccaatcacttgctgaactgatgcgggcggaatgctctttgcacagtgttgaatttcaacttgacattgaagaaacgtttgcgatttgccacgtaaatgaatcgatgtttaagcaggttatgcttaatttgttgcgcaattcgattgaagcttatgaagagcagtcaactggacggcggttggaaataagaagcagagaagttggcgagcaagtagttattgagctgatcgataatggcaaaggcatgcctgatactgttgtaag

SEQ ID NO: 8322 - DNA, 420 bp, Bacillus clausii
atgtcaaagaaaagcatttactttttatgtacaggaaactcatgccgcagccaaatggcagaaggatttgggaagcattatttatcagatgagtgggaagtctatagcgcgggaattgaagcgcatggtttgaatcccaatgccgttaaagcaatgaacgaagtagggattgatatttccgatcaaacgtccgatctcattcatgtagacatgttaaacaacgctgactttgttgtgacgctatgcggcgatgcagcagacaaatgtccgttgacgccagcacatgtgaaacgtgaccattggggatttgatgatccggcgaaggcagaaggtaccgaagaagaaagatggatggtctttcaacgagtccgagatgagataggaacacgtataaagaaattcgcagaaacaggagaataa

SEQ ID NO: 8323 - DNA, 232 bp, Bacillus clausii
atgcgatttgcttttttatcggatattcatggaaatgctacagcgcttgaagctgtcttgaatgacttgcaaacgaagcaaattgatcagacgtacatattaggagacctttgctttcgtggcccagaaccaaaacgggtgctagaactcgtacaagcttctggcgcacgtgtcatcaaaggaaatgcagatgagtggctcgtgcggggctttaaagatggcgaagtgcctg

SEQ ID NO: 8324 - DNA, 363 bp, Bacillus clausii
atgtcaaaaaaagtattggttgttgatgatgcagcatttatgcgcatgatgcttaaagacattttaacaaagaacggttataacgtagttggagaagccaatgatggcaaccaagcagttgaaaaatataaggaactatcccctgacttagtgacgatggatattacgatgccggaaaaagacggaatttcggcgctgaaagagattaaacagtatgatccgagtgccaaagtgattatgtgctcggcgatgggccaacaagcaatggtcattgacgcgatccaagaaggcgcaaaagattttatcgtaaaaccatttcaggcggatcgagtgatcgatgcgatttctaaaacgcttagttaa

SEQ ID NO: 8325 - DNA, 709 bp, Bacillus clausii
atgattgtcgctaaaagcataagccgaacgctaaatcagaatgcacaaatgtttgatggctcggcaaaagagcttggccgcttggcgcttaaacaacatgataacgtccagttaggtctttattcaaaggatcgggccttgcaattccaaagcgcctctgaggaaggggtttttgccactcaccttacgccagagggcatgttcagcaatttgtatagttggcaatcaagtgattcggcctacatttacaaggagccgatttttttgcaagaccaaattgcaggctactttgagcttcgctttgacaaaagcggcatacgcaaggaaacgaaggaagtctacatgttgacgatcctgttttttcttataaccgtaggtatcacgcttttcattgtacagcactggtttaaacggaatatgctcgttccttttgcttggatgaaagcggaaatggacgaagttgcttatggaaaacaaaatcgtacgacccctgttaagcgggggcgtacggaagttggccaactgatggacaattttgcaaacatggcagcgcatttgcgagcaattgatgcccaaaaacaaagtgatgacgaagatcgcaagaagctgattgcagcgatttcacatgatttacggacgcctttgacatcgatacgcgcgtatgcagaagggatgcacgcccaccctgacaaaagggaggagtacagca

SEQ ID NO: 8326 - DNA, 771 bp, Bacillus clausii
  misc_feature (1)...(771): n = A,T,C or G
tttgccaccatcagttccaaggggcaatgattgatctaaagttacctgatgcgaatggacttgcattacttaagcatgttaaaaggngacaaccacaatgtaaagtcatcattatgacagggtacagtacaatcaaaacagctgtcgaggcaatgaagctaggagcgagtgattacatagaaaagccttttgatgatattgatttgttagaaaaacaagtggacgacttgctcgttgccaacgggacgtctaatgagcagcggattctcgatctggcgacaaatgttggcctgattgtgggacataatgaggccatgagacaggtgattcaaacggcttataaagtagctgggaaacatgtgaatgtgttaatcgggggagaaacagggacgggaaaggaagtgttcgcacggtttatacaccaagcgagtcaacggtgctatgaatcatttatcggagtgaactgtggcgcactgtctgagtctttattggagagtgaactttttggacatgaaaaaggtgcttttacgggagctacacaaaaacgaaaaggtctttttgaaattgccagcaaaggaacgttgtttctggatgaaatagcggaagcatcaacttcgattcaagtgaagcttttgcgtgtgcttgaaacccgcgagtttatgcgtgtaggtggagagcgaccgctgcgtactaacacccgtttgcttgctgcaacgaacgaagaccttcaagaagctgtgcagcagaaaaaatttagagaagatttatttt

SEQ ID NO: 8327 - DNA, 1347 bp, Bacillus clausii
atgagagtcctgcttgttgatgatgaaccattaattgttgaaggattacaacgtttaattaagtgggaggaaatcggctgtgaagtcattggcacagcgcttgatggaaacgaggcacttgcccgctacagcgagctcccgtgcgaccttgttattaccgatatttgtatgcaccaatgtgacgggttagaattgatcaggcaatggaagaacatccagccttctacgcgatgggtggtgttgtctggtttccaggactttgagtatgtccagagcggattaaagctagggattgaaaactatttgcttaaaccggttgatgaccgtgaattagtggcgaccatagcacaagtaaagcggaaacgggagcacgagcagaaagagcaagtggctgcgctcattttgcgcgataacgctatatggcgctatttaacgggagagatgggaaggcagcaatacgaagaacggatgcagttgtatcgtcaacgccaaagttctttttttaggcagctacatgtacttgcggttccagccatcccccacttggacgatcaagccatccagcgttttcaacagcaagcagaagcggtcattgctccaggtgtttgctgccggacaccggaaaatgattttttgcttcttacaaacacagcagtgacagagaaaaccatcgcttcaatcattgctctagtcgacgacctgttcgcggttccttttctgcttgtgaaaggagagtgggaacacaaaagcttgtcccagttaacgagaacattggatgtcgcctctgcatttaaaacgaaacgcgcattgtttaaccaaacggaaatcgtcacacaaaaggaagcggtgcggtttttgcaacaagtgcctgctgagagccgcgtccactattttcgtttgcaaaagcatttaacgcacggggaggttcaagaggcgaaagcatgggcacaagcggccattgtcggaaacggcatcgatggggaggcggccaggcgaatcgccgcagaggtgatattagtaaccgaacaaatgggaagtgagcgttcaggcatagctgacatgcaacaattattccaagcgcctattctttcagagctgctagacatcgtcaatggcctgattgaacacaaagctgccgagttgcaaaaaaagcaggaagtcagccacgtcgtattgcaagaagcgctagcctacgtggacgagcatgtcgcatccgatttatcgctcaagcaattgggacagcgcttttttataaacccaatctatttagggcaactgtttcaacgggaaatgggggtaagtttctctgaaacatcaaccagaaaaggattgcactggctaagcagc

SEQ ID NO: 8328 - DNA, 456 bp, Bacillus clausii
ttggtggcgcttttttaggcttgttgatcgctaggcctactattcaaatgcctgcctttaccggattttataatgacacgctcggctttttgtttccaattttgtttattacgattgcctgtggggccatttctggcttccattcacttgtttcctcaggaacgacgtccaaacagctgaataacgaaaaaaatggccgctttgttgcttatggttcgatgctgatcgaggcatttgtcgccatcatcgcgattggttccgttgcttatttaacacttgaccaatttaatgcgcttatggccgaactgaatgatccgattagtgtgttttccgtcggcatcggccactttatgaacacgtggggattgcctgtggcagctggtgttaccgtttactgcactcgccgcatcggcattcttaatgacaacacttgattcggccacgcggctcatgcgt

SEQ ID NO: 8329 - DNA, 563 bp, Bacillus clausii
aaaggccgacattgcggacaacgatttttttactcgtttcagcagtcgtcattgcggcgttgcttgtgacggaccttcttatccatcggacgattgaagaagaaattgagcaaaatcaaacggaaaaagcgcagcagcttgccagggcggttgcgcttatgcctgttgtccagcaagcgttagtcgaaaaagagacggaacatgtgcaacagtacgttgaaacctttatggaacaagctgatgtccaatttgtcgttgtcatagatatggacggaatccgttatgcccacccagaacgagaaaaagtcggtaaagctttcgttggtggagatgaaacagaagcgctgaacgggaatgaaactgtttccacgtctgttggaacgttaggcagatcattgcgggcatttacgcctgtttatgcggagacaggcgaacaattgggggcggtcgcggtcggcatttccctgaaagttgtggaaaaagctctccaagcaaaccgcgtaaacttgctcattggcacactgtttggattaaccgcaggtttatttggccctgttctgtta

SEQ ID NO: 8330 - DNA, 621 bp, Bacillus clausii
ttcttgtaattgagatgggagaacaattatttgcgttaaaaacgggacctgtctcccatgttcaccgcacccactctagcacaatcaaacagccagacgctgtcacaaaaggaaaagaagcttttgtgagcggggtgattccgttgccggacaatggcgttgccttctcccttgatttagagaaggtgcttcactttatccaaccgtctcacatgcaaggggcaatggcaacggatgagcgccgtcgcaactacccgcttctattagtagaagactcaaaaacgttgcgttcgctccttgttgatgcattgagagaggctggctatgaagacgttacaacatttgataatggaagggatgcgtcccgttatttgtcggatgatgcatgcccactatatgaggcgatcgttaccgatatagaaatgccttatatgaacggccacgaactgacgaggcatttacgccaagacagtcgctatcaagaaacccccgttattgcgttctcttcgctagacaaaggactgatggaacgaagaggggaagaagctggcgtaaccgagcatgtagccaagccagacatccatcaactcgtcgatgcccttgatcggcaactactggaaa

SEQ ID NO: 8331 - DNA, 518 bp, Bacillus clausii
caatacatttcctgaatgaaatatgtgtcccaaaacaagacggatctttgccggctgacattaacgtaaaaccgacttagcgccatttcattggaagtgttgttggcggacgcttcagcctataaaggaagcaaaaacgttaaaatcgtctgccaaaaaaacgagttaacggcagctgaagtcgacaaacatcttctccatcgtgctttgctaaacattgtcaccaatgcgattgattacacacctgaacaaggatctattttcattgaggcagcctgcacgccaacgactttccactttactgtgacggacaccggcaaagggttttctgctgaagcattaaagcgggcgacagagctcttttttatggaagagaaaagcagacatccaaacaaccattacggcattggccttactttcgcttccaatgttgccaagcttcataatggcagcctctcgattgagaatgccgcttcaggagggggttccgttcatgtagcgattccgatcacagccga

SEQ ID NO: 8332 - DNA, 195 bp, Bacillus clausii
  misc_feature (1)...(195): n = A,T,C or G
taggcccagtagatgcacaaaagccagttggagatttgaaggaaggagggcttggtttattcctcatcagnagtttaatggataaagttgaaatcaatgaagataacggcgtgatgctcgtcatgacaaagtatctttacgagagtggggtggaggaaagtgtcgacggaatctcttccttacagtcagaacaag

SEQ ID NO: 8333 - DNA, 788 bp, Bacillus clausii
  misc_feature (1)...(788): n = A,T,C or G
ttctcctgacaaaaccctattcgatctatttcaatgaaatttcaaatggcattcgccaccttgcccgcggcgactttagccacaccgtcaatatccagtcaaatgatgaatttaaagatattgcaaaagacataaatttggccagtaaaacattgcaagaggcgattcaacggggagacttttccgaaagtagcagagatcaattagttgtaaatttagcccatgatttgcggacgccccttacctctgttctcggttacttggatttgctcctaaaagacgagcagttaacgaaagaacaagttaaacattatttaacgattgcctttacgaaatctacccgtttggaaagactgattgatgaattatttgagatgacgaaaatgaattatggcatgcttacagttgaaaaaaagacaatcgatttaactggcctccttcatcaattaaaagaagaactatatcctttacttgaaaagaaccacctgactgcccggatgaagtgtgcccccgatttattcatgagcggggatggtgatttgctagcacgtgtatttgaaaatttgctgacgaatgcgatccgttatggaaacgatgggcagtatatcgatgtaaatggttttatggatgaaagcggcgaggtcgttgtgcaagtagtcaattacggcagcagcattcctgcagaggagcttcctcatctctttgatatgttctatattggcgatgaggcacgaacccataaagaaaatcggacaggccttggtttgnttattgcccagaatatcgtc

SEQ ID NO: 8334 - DNA, 315 bp, Bacillus clausii
  misc_feature (1)...(315): n = A,T,C or G
tgtccgccattgtgggaaacacaagattggcagngacggcgaagtgaacaagtttgacattcggtttngccagcctaataaagaagcgntaaaacctggcgtgattcataggttaggacatttgcttgctattaacattcgtcgcttttcagaggaagatgaccatntcgatgtcatcgatatttccccaatgggttgccaaacaggctatnacttaattatgagcggcaccccgtctgtngaagaaatcatcgatgtgcttgaaaagacaatgacgtattcgctgtcgattgagacctctccttcggcaacaga

SEQ ID NO: 8335 - DNA, 1401 bp, Bacillus clausii
atttgtcgcctttaaatatgatgcggctagaggaggaatacggagggcgaattgaagatgtcttagtgcaaagggtgtttttctcagaagacaaacgcaccgggattggcaccttttcgccgtcagatccaaagtcccaagacattgccgacttaacagggagcatcgacttctcgactattgctgaatttgggtctgaatccgatccgcgtgcataccgctttgatggggagttaaacaaggcaaaccgcggtatgatggaatttcaagaaatgctgaaatgcgatgaaaaatttctatggcatttgctgtcgttgacacaagaaggcaattttaaagcagggcggtttgcgctcatttcggccgatgaactcatactagctcatacaaacgaatcagagtacaaatcgtttatctccaacaaaaaaaatgaggcactccattcaagaatcatcgtcatgaaaatcccctacaatttaaaagtttcggaggaagaacggatttacaaaaaaatgatcgctgaaagcgacttagctcatgtccatattgccccccatgctttgaaggtagcagctatctttacgattttaactcgtttaaaagagccccacaaggcgggaattgacttagtgaaaaaaatgaagctctatgacggggaagcggttgaaggatacaacaaccaggatgtaaaagaattgcaggccgagtttcctgacgagggcatgagcgggatcgacccccgttatgtgatcaaccgaatttcgtcagcgattatccgcaagcaattaacatcgatttccgcgttggatgtgctccgttctattaaggaagggcttgacgcccatgcttcgatttctaaggaagacaaagagcgctttatcgactacattacgattgcccgcaaagagtacgatatgattgccaaagaggaagtacaaaaagcatttgtctattcttacgatgaatcagcgaagacactaatggacaattaccttgacaatgtggaagcttattgcaacaaaaacaaactccgcgaccctcttacaggggaagaaatgtcgccagacgaaaagctgatgcgttcaattgaagaacaaatcggcatatccgaaaatgccaaaaaagcatttcgtgaggagattttaattcgcatatctgcctatgcccgaaaagggaagaaattcgactacaactcccatgaacggttgcgtgaagcgatccagaaaaagctattcgccgatttaaaagatattgtaaaaatcacgacttctgtgaaaacgccagatgaatcacagttgaaaaaaatgaatgacgtcatcgcaagactcattgatgaacatggctataactctgtttcagctaacgaattactccgctatgttggctcacttttgaaccggt

SEQ ID NO: 8336 - DNA, 336 bp, Bacillus clausii
  misc_feature (1)...(336): n = A,T,C or G
tacaaaaactaggaagcaagagcttntcattaaaanaagtacatgactttgattggctttcaaaactaggtgatgtctttgctgtttttgaccaacaggactctggaaatgtaagtttcggtgtagcggatggggctaagaagtggtttgttaaatatgcaggtgctaagacgctttattataaggggaacattcaacaggcggtagagcgtataaaagaagcggttgctgtttatgaacatcttgctcatccaaacttggttacattgcatagccatttcgccacgaaagggggctatgcccttgtgtttccttgggtagagggcgaatgtttgc

SEQ ID NO: 8337 - DNA, 726 bp, Bacillus clausii
gtgatcaagaccatggcattgttttcaaaggagaagatgatcgccatttgccctattttttaacttttggcgaaaggattgtgacacggcttgaagctgctggctatgaacgttgtattggcggcgtgatggcctcatgtgaacggtggtgcggttcagccgaaaaatggtctcaacagctggaacattggctcacagaagatacgtttgaacatgtgcgctatgttctcacatttttcgatgcccggacgattctaggagaacatgcattagttttagacttgaaaaaacaattgtttgcccaaatggagcgctctccccacttaatgaaacggtttgctgacaataccggaagaatgccacaagctcgcaatttatttgggcaactccttgttgagcagcgcggtgaacaccaaggggccttaaatgtgaaagagcaaattctgtttccgtatgtcaatggcatgcgcttgcttgctcttcagcagcgcatgatggctacgtcaactttagaacgattcgcggctctcccgccgggtagcggttttgaggaagctgaacgctcttttgcctccttatttgagcggcgggcttactggattaagcagttttcttcctataagtacattatccctagccaactaacaaaagaagaacgcaatgacttgaaaacgtgggcaaaagaggggcgccgcctttatgaaacaatccagaaaatcgttgagg

SEQ ID NO: 8338 - DNA, 495 bp, Bacillus clausii
aggtttgtttgcgccgaagacctctaattatcgtttatgtgtgttccaacttcacataccaccgttgcgtgagcgaaaagaagatatccctttgcttgccaaaacgctgcttgccaaccaatctgacgcgaaggcagtggggcaagtaaacattagcgacgaagcattggaaaggcttaagcactatcattggcctgggaatgtgcgtgaactaaaaaacgcgctccaatttgccttgtgcatgatggatgaacccgttttgcacacaagccacctgccgccacatttggcaacggacctatggcaaaggtccacgccaatgtcgtttactcctcctacgtcattgaaagcaggcatggaggaagctgaacggcagcttatgacaaacgtacttgccaattgtgcaaatcatttagaaggcaaaaagcaggcagcaaaacgattaaatatttccttggcaacgctatacaataaaatgaagaaacaccgtttgtt

SEQ ID NO: 8339 - DNA, 213 bp, Bacillus clausii
aaggtttgtttgcgccgaagacctctaattatcgtttatgtgtgttccaacttcacataccaccgttgcgtgagcgaaaagaagatatccctttgcttgccaaaacgctgcttgccaaccaatctgacgcgaaggcagtggggcaagtaaacattagcgacgaagcattggaaaggcttaagcactatcattggcctgggaatgtgcgtgaaa

SEQ ID NO: 8340 - DNA, 1557 bp, Bacillus clausii
  misc_feature (1)...(1557): n = A,T,C or G
atgagcatacggatgctaatcgtggatgatgaaccagtcatttgtcaagggcttgtacaaacgattccttgggaaagtcttggtgtagaagtggttgacactgcttttaatgggaagcaagctttacaaaaactagaacaacagccagttgatttaatcttaacggatatctcgatgcctgaaatggatggacttgcacttgcggagtatatcgttcatgaaaagccggaaacgaagatgatcattattagtggctacgataaattcgactatgcacgccaagcgcttcgtttaggaatagaagactatttactgaaaccggtggatgtggatgaattaatggagcttgtgaaacaagtgacacaaaaaatcgtcgatgacaaaaagctgaaaagcagccaagctcacgattggattcggcatgtgttgtttcacatccctctatcagaacaaattgacgtcaagcaaacgcaatcgtgtggcatgtttcggcttttgattagcgaagtgtcgggatatgctcacctctttaaggcggttcctacagaagaaagtaaacaaatacaagataaagtaaggcacgtcgtagaaaagacatgtgaagcttatggtgtgaagcaaatttcccttattggntatgaaaatgagttattgacagtagtggttagcgaccactcagacatgctttcagatttctggcttcatgaagtgtgggaagaggtcctgaaacagagcccgtatcccattcaaaccgtggcttcgtcgattggcgagtctctttccaccagttaccagcaagcgcttcgtcttcttgacgatctgcgcggtcatgggattggcctctatacgaaaggcattgaatgtgatcaagaagcgtttgatcttgacaaaacggaacatcgtttattggaaaccgtgctacaacatgatgaaagtaaactagcagaatgtattcgccatgtcgtctcggagctaatggcaaaaggatattccctccgctacttcgtgaaggtttgccaagggctggaaataagaataaaccaagcgctccaaaagcggttgccgaatagatcgtttgattccattgaactacggttacacggaaaacttgatctccgttattacaacacatcaagcgcaattgaagaactatttcttcgtgatctcgtcgattttcttggagaattaaaagaagacgaacagaataactggatgattgagaagattaaacattacattcacaagcattatcagcaagatttgcgggcggcagaagtggctgagcgtcattttattacgccaaattatttcagcatgcttttcaaaaaagaaacaggtcagagtttctcagagtatgtaaatcgcctccgtatcgaaaaatcggcagagctattgctaaccacatcgaataaagtctttgaaattgccgagtatgtgggctacaaagaatacaaatattttgtgcaagtgtttaagaagcaagtcggattgacgccaactcagtaccgacgactgaatgtaacccgagatagaagagaaaaacagatagaatcgtaa

SEQ ID NO: 8341 - DNA, 372 bp, Bacillus clausii
cacaagaacgaaaccggatcgcacgtgaactccatgattcggtctcacagcaattgtatgcggcatcgatgctcttatcggcggctgtaaatggaaagaatccagatatagaagcactgcaaaaacggtgcgagcaaattgaaaaagtggtgaatgacgcccaaaatgacatgcgcgctttgctattgcaactacggccaatccaattggaagaccaatcctttaaagaaggggtcgaacagctcgtagacagccttgccgaaaagcatcccctatcattttctgtacggattgccgacgctcccctttcaccaggcattgaggatcagctcttccgcattgcccaagaagcgattgccaacgcattgcggc

SEQ ID NO: 8342 - DNA, 639 bp, Bacillus clausii
  misc_feature (1)...(639): n = A,T,C or G
gcaaaagcagcaccaaatgtttattaatcagtgggttcaccatatgaaaacgcctgtttccgttatttccctgctcgtccaagagggaaaacaaacactaaccgataaagaatggcttgacgacataagtgccgaaaacgaccgcttccgccatggccttgaactgatgcttcaccttgctcggcttgaccacttttctctcgacttaaaggcggagctcgtcgatcctgcagcaattgctcgggagctcattaatgaggaaaagcgccagttcatccgtcggggcatttttccagaacttgatgctgaggaagctgaaccggtcgctagcgacagcaagtggctgcgcgtcatcatcgcacagcttttgcataatgccttaaaatattcgccgcaaaagcaacaagcacgcatccgtttttcatttaaaaaacagcaccatcaacttgaattttcaatagccgattcaggtgtaggcatcccagcaaaagatttgccccgtgtatttgatccgnttttcactggtgaaaatggcaggcgctaccaagagtctacaggaatggggctctatttagcgcaaacgatcgcccgtgaactcggccacaggctctacttacattctgagcctggcaaaggtac

SEQ ID NO: 8343 - DNA, 483 bp, Bacillus clausii
  misc_feature (1)...(483): n = A,T,C or G
tgaacggaaaacattgccgatatcgttgacncntttgtttgaacaagtcgtttcagcggagaaagaagagctgcaagaactgtccgttcaagggcgaagtatggctgtgttgatggcgcctctctatgctgaagagcatgtccgcggcgctgtagctgttgtccgtgatgtaacggaagagcgccgccatgacnaactgcgcaaagatttcattgccaacgtgtcacatgaactgcggacgccaatctcgatgttgcaaggctatagcgaagcaatggttgacggggtaacgtcaagtgatgaggaacgaaaagaagtcgcgcaaatcatttacgatgaatcgctgcgtatgggcaggctcgtcaatgagctcctcgatttggcgcgtatggaagcgggctatattgacttgccacgggaagaagtggatctcnattcttatttagaacggattacccgtaagtttgcaagctttgcccgcga

SEQ ID NO: 8344 - DNA, 360 bp, Bacillus clausii
  misc_feature (1)...(360): n = A,T,C or G
attttgccaccatcagttccaaggggcaatgattgatctaaagttacctgatgcgaatggacttgcattacttaagcatgttaaaaggngacaaccacaatgtaaagtcatcattatgacagggtacagtacaatcaaaacagctgtcgaggcaatgaagctaggagcgagtgattacatagaaaagccttttgatgatattgatttgttagaaaaacaagtggacgacttgctcgttgccaacgggacgtctaatgagcagcggattctcgatctggcgacaaatgttggcctgattgtgggacataatgaggccatgagacaggtgattcaaacggcttataaagtagctgggaaaca

SEQ ID NO: 8345 - DNA, 320 bp, Bacillus clausii
atttgtcgcctttaaatatgatgcggctagaggaggaatacggagggcgaattgaagatgtcttagtgcaaagggtgtttttctcagaagacaaacgcaccgggattggcaccttttcgccgtcagatccaaagtcccaagacattgccgacttaacagggagcatcgacttctcgactattgctgaatttgggtctgaatccgatccgcgtgcataccgctttgatggggagttaaacaaggcaaaccgcggtatgatggaatttcaagaaatgctgaaatgcgatgaaaaatttctatggcatttgctgtcgttgaca

SEQ ID NO: 8346 - DNA, 447 bp, Bacillus clausii
aggcaatcaaattggcgccgtttctgtcggcatttcgactgaggccatcgccgcagcggtaaaggatagccaatcgatgctcatatggagcgtgttttgcagtttgctcattggcattgtcggtgcttcgatgttagggcaaagcattaaaaaaacacttaacgggttggagcctgcggaaattgctttagctgtcgaggaacgtaattcaatgcttgaagcagttgatcaaggcattttggcgatcaacaacgatggcgaagtgctcttggccaatgatgcggcgaaacaatttttgcggcgtactgggtatcatggagagtttgatggcgtgccaatcgaccgtatttggcctgagcttaagctacaagaggcgttgacggcgacaagcgcattctctagtgagccgattaagaaaggcgatgtggaaacggtggcgacacgcgt

SEQ ID NO: 8347 - DNA, 195 bp, Bacillus clausii; identical to SEQ ID NO: 8332
  misc_feature (1)...(195): n = A,T,C or G

SEQ ID NO: 8348 - DNA, 236 bp, Bacillus clausii
atcaaatttatgtattagacacaaatgtcctgcttcaagatccatatgcgatctaccaatttcagccgcatgaagtggtcattcccgctgtcgtattggaagaagtggattctaaaaagcgaaatatggatgaaatcgggcgcaatgcacgtttgatcgcaaaaatggtcgaccaattgcgtgatggcggcaaactccatcaaggggtcgtccttgatcggggcggggtattccgg

SEQ ID NO: 8349 - DNA, 531 bp, Bacillus clausii
ttccctggaaacactatggctttgaagtggctagcttagcatgcaatggcaaagatgcccttgaaaaatacaaacaccataaacctgacttggtcatcgcagatatacgaatgccacaaatggacgggctgtctttgctgaagcaaattcgcactgaaaacgaagctgtccctttcttattgcttagtggtcatgccgactttcactacgcccaagaggcgattggccacggcgtagatgggtatttgctcaagcctttagaggaagacgagcttattgagcatgtgcaaatcgtctttcacaaattggaacaaagaaagcaagcgcatgtcttgcgccagcaaagtgtacggatcgagcaagaacggcttctgctcaacctgttggaaggaaaggcgctgccgcaaagtgtagacatctctcgcctcggtcttgctgcctcacggtaccaaatatttttggtacacgctggggagagagacgcattagagcacttagccgaacagattccccacaccgtcgtgccttttg

SEQ ID NO: 8350 - DNA, 468 bp, Bacillus clausii
  misc_feature (1)...(468): n = A,T,C or G
atgaagaaaattgtcggcaccatagcggtttttattattacttacgcgcttttttcagcagccgattacctgtttccagttgatcaagaatggtaccattcactgagcaagccagaatggacgccaaatggatctacaattggagtcatttgggctatcctgtttgtcctaatctccctttctgctgctattgtatatgcagcctttagatttaaaggtgcnaaaagctactggtttgcacttttaattaattatgtgattaatcaagcattcagctatttccagtttacgcaaaagaacttgttggctgcatcgattgactccttgtttgtagccctcaccgccttggcattaatgatcgtagcaaaaaaatatagcaaagtggcaagctaccttcttttgccttatgttttatggagtgtatttgcgaccatcttatcctttacaatctattcaatgaatttgtaa

SEQ ID NO: 8351 - DNA, 541 bp, Bacillus clausii
  misc_feature (1)...(541): n = A,T,C or G
atgataggcgaacgaattggcgggcgttacgtcgttttggacagcattggcggcggcggaatggccaatgtttatttagcgctggatgtgattcttgatcggcacgtggcagtaaaagtgctccagccacaattctcagaagacgaacagtttattaatcgttttaggcgtgaagcccaagcggcgacaagtcttgccaacccgaatatcgtaaacatttacgatgtcggcgaggaagacaacgtctactacattgtgatggaatatgtgcgcgggcgcacattaaagcaagtgattcaagaagaagggcctttagacattggcgttgcccttgattattttaagcaaattttatacggtgtcggccatgcccatgccatgcagatcgtccatcgcgacattaagccgcaaaacatcttaattagcgaaaacggcgaagcgaaagtaacggacttcggaattgcgagggcgatgacgtcagcaacgatcacccatactaattctggtatgggctctgtccactacttatcgccngagcagc

SEQ ID NO: 8352 - DNA, 1138 bp, Bacillus clausii
atgaaaagcattaaggtcgatatgtcactagatgatattttaattaatatgattgataaactaaaattgcttgttcactttgatcgactgagctttttgatgttaacaaatgaaacgttaagattaagtcatgtttatcctgaagatcactattcgttagaaattggctcaaccattccaaaggcccagtccctctattggtcagcattagacaaaaggcaaacggttctccaaagtttaacggatacgaatcacgctttttacgagaaaccatatttagctgtacttgagcttaaatccattttagtcatacccatttacagtaaaaacaaacggattggcgtattgagtatcggtcggaaacaagaaatagactggagctctgacgacctagcgtttttagagcaattaacagatcatttagccgttagtatcgaaaatgtcgaattatatggtcaagttttacgatcgaaacaagagtgggaagatacgtttaaagcagtagatgatatgatcgttgttttcggtcaagaaggaaacgtggttcaatttaatgatgcggttcatgagtttcttcagaaccacgaattaacccatatttctgctttggttgcccactgtgagccacttgttaaggaaacgttctactccgaaaaagcaggccataaggaaatccatctccgcaatcaaaccatttgtgagctttctacgtacccccttctcaataacgaacaggtgatgtatggggtgattgcttatatcaaagatgtgacggaaaagcgaaaaatggaagtacagctcatccattctggcaagctagcggctatcggtgaaatggcagcaggagtggcacatgaattgaacagcccgttaacggccattttagggaattcacagcttatccttagaaatatgaacaatcatgattcgttgtttccacttttaaccgacataaaaaattgtggcgatcgttgcaaacgaattattaatagcttgcttactttttcgaggcaggacgattttgtgtttgagtcttgttccatcaacgatgctgtgaatgaaacattaaacctgttaaagtatcaagttggaaaagaaaaagtaataatcaaaacagaattaccaaaaggacatccct

SEQ ID NO: 8353 - DNA, 666 bp, Bacillus clausii
ggatccccttttatggcatgatgattgcagaaggcatgattgcgatgatttgggcagcggcggcaatgagtttatttgatggccctgtcacgcttaatgaattaatctccactatcggcacaggcggcatcgtgtctgaaatttcaacaatgatgctaggcccaattgttggcacactagcgattctcggcgtcatcattttgccgattacatctggcgacaccgctttccgtagtgcacgaatgattattgcagattatatcaacgtgccacaaaagaaagtgatgaaccgcatttggattgccgcgccattgttcattacgtccatcatcttaacgacagtagatttcacaatgctgtggcagtactttaactgggcgaaccaatcgaccgccgtcatcgccctttggattggcgccatgttcttatacattgcccgccgaaattactggattgcaatttttccagcctggtttatgagtgtgacggcagcgacttatatcgtcaatgcgccaatcggctttaacttgccaatgcaagcatccgttatcatcggcgtaggctttaccgtccttttgaccgtgttgttttttaaagcagcccgtaaacgacggagcggaaaccttccgattgaagaagatatttccgaatgggaaaataaacaaa

SEQ ID NO: 8354 - DNA, 513 bp, Bacillus clausii
aacaaatgaagcagccgccatttattgtatttgccacagcctacccgcagtttgccgtagaagcctttcagctacaggcaaaaggctatttaatcaagcccattgatgaaacacggcttgccgaaacaattgcccaagtggaagatatgctggcgctcacagcagaacgggaacgaacaaagccacctgcaaaactagccgtcgaaggggacgatgcaattcactttttggaaccagagtcgatcgcatacgcatatcgcgatgagaaaagcaccaaagttatcacagctacaggcgcctacgaaacacggctgacgttaaaagaactggaaacgcggttggctccctattcgttttttcgagtccacaaaagctatttagtaaacacagcctgtattacggaaatgaacgcctggtttaatggggcttaccaattaaagctaaaaggcattgacgaccatattccagtaagccgcaactacgtgaaaccccttcgttcgcaaatcgaacttt

SEQ ID NO: 8355 - DNA, 450 bp, Bacillus clausii
ttttgaacttgaccatacgattgtaaaggccccgtatgtccgccattgtgggaaacacaagattggcagtgacggcgaagtgaacaagtttgacattcggttttgccagcctaataaagaagcgctaaaacctggcgtgattcatacgttagaacatttgcttgctattaacattcgtcgcttttcagaggaatatgaccatttcgatgtcatcgatatttccccaatgggttgccaaacaggctattacttaattatgagcggcaccccgtctgtcgaagaaatcatcgatgtgcttgaaaagacaatgacgtattcgctgtcgattgaaaccgttcctgcggcaacagaaaaagagtgcgggcaagcggcattgcatgatttggaaggtacgaaagaagtcatgcgcaaatggctgtctgaagacaaacattcgttaaagcaagtatt

SEQ ID NO: 8356 - DNA, 453 bp, Bacillus clausii
ttgcgatcgtcgctgacggcatgggcggccactctgccggcgatgttgctagccgcctggcgacagaagtaatggaggctgagtggcgcaagttaaaagagcctctgtcagcgtcatctgcagaacaatttttaaaggaggcgtttgaacacgccaatgcctcgattttggcccacgccaaagagaaccctgattgcgaagggatgggcacgactgctattgctgctgtctgtactgaagaatacacgacgattgcccacgttggcgatagtcgcgcctatatttataatggaaagcaattggtccagcaaaccgatgaccattcacttgttgcagaactggttcgcagtggccaaatttctgcagaagaagctgatcaccatccccggaagaatatcgtgctacgggcactcggtacagaagcgcaagtgaaagtcgattcttttacgattc

SEQ ID NO: 8357 - DNA, 233 bp, Bacillus clausii
tggtttgcacttttaattaattatgtgattaatcaagcattcagctatttccagtttacgcaaaagaacttgttggctgcatcgattgactccttgtttgtagccctcaccgccttggcattaatgatcgtagcaaaaaaatatagcaaagtggcaagctaccttcttttgccttatgttttatggagtgtatttgcgaccatcttatcctttacaatctattcaatgaattt

SEQ ID NO: 8358 - DNA, 575 bp, Bacillus clausii
aaggattttattcaactctattcggaaattggtgagttgagtgcaagccagatcgacctcatgaatatagaattggagcgaattgaaaacattattaatgactatgtgctgttagctgaagaacctcctgcccgagaaaacgaatcgattcaaatggcagcctttttgcagtcgctcttaaaaaagaacaaagtgaagcagcttaccgacggtcaccctattaagctaaacattaacgaggaagcaaccgtgttggggtcaagaaaagagctttttctattgttttacaacttgctagaaaatgcgattgatgctagtttgaaacattcgcctgtgcatattaatatgtatgcggaaggcgcaaatgtttgtgtggaaataacagactttggttcaggaattccagcggagagactccattatattggccagcccttttactcgacaaaagaaaaaggaacaggccttggcttaatgatttgttatcgtgtagccgaaacgcatggcggcctgatcgacatcgagtcgaaaaataaaaaaggaacgaatgtaaaagtcatcttgccaatgacaac

SEQ ID NO: 8359 - DNA, 672 bp, Bacillus clausii
gatttatacgacgaaaatattgcaacgactgtaaaagggaaaaatatccgcgcaaaatcacttggccaaaggcactatgtatcgacgattaaaaaacacgacatggtttttggtgtcggcccagcggggactggcaaaacctatttagctgtcgtcatggcttgttgctgccttaaaagagggccatgtgcaacggatcgttttgactaggcctgctgttgaagccggagagagcctcggtttcttgccaggggatttgaaagaaaaagtggacccttacttgcgtcccatttatgacgcgctccatgaagttttaggcgtggagcatacagcaaggttaatggaaagagggacgatcgaggtcgcgccgcttgcctatatgcgagggcgtacacttgatgatgcgttcgtcattttggacgaggcccaaaacacaaccgaagagcaaataaaaatgtttgttactcggttaggttttggttcgaaaatggttataaatggagacttgacacaagtggacttgccaaaaggcaaacggtcaggtttacaagcagcattggcaaagctgaaaaccgtgaaaggcattggtttcgtttacttgcaagcaagcgatgtagtcaggcatttgctagtccaacgaattcttgaggcatacgaacgtacagaaaacga

SEQ ID NO: 8360 - DNA, 282 bp, Bacillus clausii
ttggctttcaaaactaggtgatgtctttgctgtttttgaccaacaggactctggaaatgtaagtttcggtgtagcggatggggctaagaagtggtttgttaaatatgcaggtgctaagacgctttattataaggggaacattcaacaggcggtagagcgtataaaagaagcggttgctgtttatgaacatcttgctcatccaaacttggttacattgcatagccatttcgccacgaaagggggctatgcccttgtgtttccttgggtagagggcgaatgttt

SEQ ID NO: 8361 - DNA, 1380 bp, Bacillus clausii
  misc_feature (1)...(1380): n = A,T,C or G
tattaaagcacaccccgttcgttccaatgaaaatggcactggcgaaattctcggtgctgtctacattgaagcgtcaattgagggtgtcagtaagcaagcacaagcgatcaacggcatttttatctcggcgacaggtattgcgatggtgttgacgttcttagtggtcattctactggcccgaacgatcacgatgccgattcttgacatgcgtcggcaagcgctccgcatgagccatggcgatttttcgaggcaagtccgtgtctacagtaccgatgagttaggccagcttgccactgcgtttaacgagttgacgaataggctccatgatacgacattaatgagggacagggagcagaagcgtttgcgttcggtattggcccacatgacggatggcgtgattgcgacagaccaaagcggcttaattattttgatgaaccgccgcgccgaagaactgttaggcattccgttaaagcatgtgctgcgcaggccgattatgaacgtgctgcgcatggaagaggaagtgagcatttttgagctctacgaaaggaacgagccgttgctccttgacttaagcacaggcgaagagccgattgtgctcgaagtgaacttttcagcgattcaagaagatgaaggccccttcaatggcttgattgcggtccttcacgatgtaaccgagaaagagaaaattgaaaatgaacggcgcgaatttgtcgccaacgtgtcacatgaattgcggacgccgttgacgacgatgaaaagctacctagaagcgttggcagacggggcgatgcaagatgaggacaatgcgccgcgctttttagaggtaacgcaaaaggaaacggaccggatgatccgccttgtcaatgatttgctccagctgtccaaaattgactcaaacgattaccgtctcgacttgcattgggtggagctcggtgcctttttgcatagcattgtcgaacggtttgaaatggtcgtcaaggacaaaaacattgattttcaccgccatattgcgaaacagccaacttacgtcaaaatcgataccgatnaaatgactcaagtgctggacaacattttatcgaatgcgattaaatactctccgtntgggggcaatgtgaccatcaccctcctccatcaaggaaacaaagcacggattagcattgccgatgaagggttaggcattccagctgagtcacaagacaagatttttgagcggttctatcgagtggacaaagctcgggcgcggaacgttggagggacaggtctcggccttgcgattgcgagcgagtatgtccatgcccatgaaggcgatatttgggtccatagtgaatacaatgaaggcacgaccatttatatcacgttgccttactcgacattcaaagg

SEQ ID NO: 8362 - DNA, 567 bp, Bacillus clausii
gcaagaacagtcggcgtatacgcactatattttaaacgcggtccataaaatcgagcaatacatttcccaattgatccacttgtcccatacagacggatctttgccgctgacattacgtaaaaccgacttagcgccattcattgaagtgttgttggcggacgcttcagcctataaaggaagcaaaaacgttaaaatcgtctgccaaaaaaacgagttaacggcagctgaagtcgacaaacatcttctccatcgtgctttgctaaacattgtcaccaatgcgattgattacacacctgaacaaggatctattttcattgaggcagcctgcacgccaacgactttccactttactgtgacggacaccggcaaagggttttctgctgaagcattaaagcgggcgacagagctcttttttatggaagagaaaagcagacatccaaacaaccattacggcattggccttactttcgcttccaatgttgccaagcttcataatggcagcctctcgattgagaatgccgcttcaggagggggttccgttcatgtagcgattccgatcacagccga

SEQ ID NO: 8363 - DNA, 396 bp, Bacillus clausii
gcgagatgaacattctcattgttgatgacgatgcgctcgtttgccagagtctcgaactgcttcttggcaacgaagatgattttactgttatagggactgccagcaatggccgtgaagcgcttacacatatagaggaaaaagcgcctgacctcgtattgatggacattcgcatgcccgaaatgggtggaattgaaagtacaaaagagatcaaaagccgctggccagaaatgttaattatgatgctaacaacgttccaagatgaacaaaatattcgcctcgctttgcaggctggagcagaaggctatttgctcaaatcgacagcggtagccaatatggccaagcaaatccgtgccttaagcgctggttcatctgtacttgacgccgatgtgcttaagc

SEQ ID NO: 8364 - DNA, 906 bp, Bacillus clausii
aaagtgaacagcaaaatggtcccccttgaccatgaacttaaaaacgggtgacattgtcgaagtgatgacgtcgaaacactcatatgggccaagccatgactggttgaaaattactaagtcgtcacatgctaaaaacaaaatcaaacagtggtttaaaaaagagaaacgcgaagaaaatgtcctcaaagggaaagaagcaatcgagaaagaaatacgggcgcttgattttgatgtaaaagacattttaacgcacgaaaatttacaagaagcgattagcaagttcagttttgctggcgaagaagatatgtacgcagcagttggttatggcgggattagcgctaaacaaattgtcaatcgcctaactgaaaaacaacgcaaagcaaaagacagcgagcaggagcaacaatcccttgacgctgtgctaaacgaaatccaaacggtttcgccaaacaagcggacaaattcaattggcgtgcatgtaaaaggtgtcgacaatatgcttatccgcctagcacgatgttgcacgccagtgccaggagatgagattgtcggctacattacaaaaggccgtggcgtttccattcatcgcaaagattgcccgaatgtcatagccgattcagattcgtcccgtttgcttgaagtggaatgggaaggaaatgagcagcagggcaagtcgtataatgtcgacattgagattactggatttgatcgcaacggtttgttaaatgaagtgttgcacacattgacagaaacgcgcacgcaaattaatacgatttctggccgttctgaccataagcataaactggcgacaattgaaatgagcatttctatttccaatatcgctcatttgcaaaaagtggtagacaaaattaaacagttaaaagacatttactctgtacggagggt

SEQ ID NO: 8365 - DNA, 206 bp, Bacillus clausii
atggcaaagcggatactcgtagttgatgacgaaccgtccatctcgacgctcttgcaatacaatttagagcaagcgggctttgaagtcgaaaccaaattggatggccaagcaggttttgaccgagcaaaagaagcagattttgacctcattatcctggacctcatgctccctggaatggatggcatggatgtatgtcggcagctaag

SEQ ID NO: 8366 - DNA, 219 bp, Bacillus clausii
ggggaagacggatcgggaagttatcgatttggttcgccaacatcagccagatgtcattttaatggatattaatatgccaaaaacgaatggcgtcgaagcaacaaaagacttgatcaaggcatttccaaaagtgaaagtaattattctttccattcatgatgatgagtcttatgtttcccatgtgttacgtacaggagcctcaggttacttattaaaaga

SEQ ID NO: 8367 - DNA, 405 bp, Bacillus clausii
caaaattcctgaaaattggatcaacgccaagctttattaagcggaaagaccacgtcataaaaattgaagcaggcaacttgccaatgggcattctccacgaatttgaagtagacgttgttagcgagcagcttaagccaggtgacttgctgattatgtgcagcgatggggtgtttgatgcgaaaaggcaaattgaaaacaaagagcagtggatgaaacgtatgattaaggaaattgaaaccgatgacccccaagaagtggccgatgtgctattagaaaaagtcattcgttcggaaaaagggattgtgattgaggatgacatgacgatcgttgttactcagttgaaacataatacgccgaaatggtcttcgattccgatccatccgaaaacgactaaaaacaagaaaa

SEQ ID NO: 8368 - DNA, 453 bp, Bacillus clausii
tattatgctgacagcccgctcagatgaagaagataccattattagggtttgatttaggcgcagatgactatgtcacaaaacccttatagccctaaaattttattagcaagggccaaacgattgcttactactccaagcgacaaatgaaaacactaacaagagtcaagaaattttaacgagccaacgaaccttgaagtccatttacattcacgtaccagttaaagtaaaaggcaatgtcgtcccattgacacatacagagtttgaaattttaacgtatctaatgaaaaacaaaaatatcgttatttccagacaacagctcattataaaagtttggggctatgagtatgcaggtgacgaccgtacagtcaatacccatattcgaaatttgcgaagcaaactggctgacagcgctaaacaaataaaaacaatcgttcgtgcaggatataaatttga

SEQ ID NO: 8369 - DNA, 507 bp, Bacillus clausii
tggtagatgatgaaaagtcgattgctgatatattaaaatttaacttggagaaggaaggctttgatgttacttgtgcttatgatgggaatgaagcattagagcgcgtcaaggaacggaagcctgatttaatgctccttgatattatgctcccttataaagatggcatggaagtttgccgtgaagtaaggaagcaatacgatttgccaattatcatgttaacggcaaaagactcggaaattgataaagtgcttggccttgagcttggcgctgatgactatgttatcaagccgtttagcacgcgggaactgttggcacgtgtaaaggcaaacttgcggcgccaacaagtcgcttctgacgatgcgccaacaacgcaaaaagaaattacaattggcgagctatcgattcttcctgaagcgtatcaagtaaaaaaacggggccgagccagttgatttaacgcaccgggagttttgagttaatccattatcttggcaaggcatttaggccaag

SEQ ID NO: 8370 - DNA, 362 bp, Bacillus clausii
atgattaaggtgctgctagcagaagaccaagtcatggtacggcaagggttaaaagcaatgattgaaaccgatgaagagatcaaagtaactggagaggctgaccatgggagaaaagcgcttcgtttatgtgagacgcaagtgttcgatgtggcgattttagatattcgcatgcctgaaatggatggaattgaagcggccaagatgatgcgcctgcgttatccgaaaatgaaaatattgatgctgacaacgtttgatgatcatcagtacgtggtcgagtccttaagattaggcgttaatggttatatgctgaaaaacggcgacacggaatcattgattcgttcaattaaaagtactataaatgg

SEQ ID NO: 8371 - DNA, 618 bp, Bacillus clausii
cgaagatgattatcgagtggctgaaattcacgaacagtttttaaagaaaatgaaaaatgttgacgttgtcgccaaagcgcaaaatgcgacagaggctgttttacttgcaaacatgcaccagcctgatgtgctgctgctggatgtgtatttaccagatcgcctcggcgtagacgttttgccagagctgcaccaagcatgccccgacatgcaaatcgtcttgattacggcggcgactgaaaaaacaattttccataaagcattgcaaaatggcgttgtcgattacttagtgaaaccaattgcgtttgagcgtttgcaacaatcggtcgataaagccaaaagcttgcgtaagtggctccaagataaacagccgattgaccagcaagcagcggatcaatttttccaaggcaccaaaaccaaacatgcgccaccagaagccttaccaaaaggaatcgaccagttgacacttgaaagagtgcgcacattgctgcgtcaacaatcggaaggagtaacggccgaagcattagggcggaaatttggcgcttcacggacaacgtcacggcgctatttagagtatttaatttcaactaatgaggcaaaaagccggagcttggaatttgg

SEQ ID NO: 8372 - DNA, 606 bp, Bacillus clausii
gcttattgtagaagatgatccgatggttgccgctgttgttaaaagttatttgcgcgatgtgccaggttttcaagtggcggctgaggctggcggagtagaggaagcaaagcagcatcttaaagaaaacaaaacaatccaattagtgttgcttgatgtttacatgcctggggagaatggcttgtcactgctgccttatttgcgcgaaaacaagatcgaagctgacgtcatccttatgacagcggcctcagacaaagaatcgatcgagactgctcttcgatttggggcagtcgattatatattaaagccgtaccaatttgcccgttttcaaaaagcgttgcatgcttaccaaagccgttacaatttctttcgtaaagaagaaacgaccgatcaaaaacagcttgatgaaacgttctttgaaaaaaaacatactcttgaaaaacaaacattgccaaagggactgacgaaagaaacactgcaagaagtctgggaggcggttaggcaagtcggtcaagatagcttttcaacagaagacatcgcccttcatgcccgtctctcgcgtgtttctgttaaaaagtacttaacgtttttgaaagaattagacgtgtt

SEQ ID NO: 8373 - DNA, 396 bp, Bacillus clausii
  misc_feature (1)...(396): n = A,T,C or G
aaagaggtggacaagcactccgtaatgaagaaattatttgtttaattatcttgcttgcctctgtaatgacaggaacagtcggttggacgataaatgaggctgtgcttcaccatacctttgccagttatctcgttttagtgtttgcttttgttggcggggctgcaataggctcaaccgtcggattggtgaccggcttaattttaaccttggcaattttaccaattctttatcagnnnnncctgnctgccccttnnnnngccttgttagaagggttgttaaagnaagggaancggatcggcgtgtcacttggcttacttgtaggaacgctcttaattggcatgtatggccaagggggcgggcttggggcaagtgtgtcagaatctgccattgcgatca

SEQ ID NO: 8374 - DNA, 705 bp, Bacillus clausii
ttcaggtgcttattgtagaagatgatccgatggttgccgctgttgttaaaagttatttgcgcgatgtgccaggttttcaagtggcggctgaggctggcggagtagaggaagcaaagcagcatcttaaagaaaacaaaacaatccaattagtgttgcttgatgtttacatgcctggggagaatggcttgtcactgctgccttatttgcgcgaaaacaagatcgaagctgacgtcatccttatgacagcggcctcagacaaagaatcgatcgagactgctcttcgatttggggcagtcgattatatattaaagccgtaccaatttgcccgttttcaaaaagcgttgcatgcttaccaaagccgttacaatttctttcgtaaagaagaaacgaccgatcaaaaacagcttgatgaaacgttctttgaaaaaaaacatactcttgaaaaacaaacattgccaaagggactgacgaaagaaacactgcaagaagtctgggaggcggttaggcaagtcggtcaagatagcttttcaacagaagacatcgcccttcatgcccgtctctcgcgtgtttctgttaaaaagtacttaacgtttttgaaagaattagacgtgttgcagctacagccaacgtatgggtcgataggccggccgattcacatttatcgaatcgacaaagacaatgttcgtaaactaaagccctatttgt

SEQ ID NO: 8375 - DNA, 480 bp, Bacillus clausii
  misc_feature (1)...(480): n = A,T,C or G
agcagccgatggagaagaggcggtccgatngttngcaaatggcggcatggatttagtattgctcgatttaatgttgccgaaaatgaacggaatcacgctttnaaagcaaatccgtgtacatagttctgtgccgatattgatcctttccgcgaaaggaagcgatttagataaagcgcttgggctagggtttggggcagacgattacatcgccaaaccgttttcgntcattgaatngacagctcgggtacaggcagcgatcaggcgtgctaccgagtacacagtagcggacgctaaggaagaacgagtccttcagcgcggaggcatccgcttggatgtagatgcgtttatggcttataaaaacgggcaagcggtgaagctgacggcaaaagagtttcagttgctgcacgtatttatggaaaacccaaagcgcgtgtttacaaaggaacagctttatcaacaaatttggaatgaacnttatca

SEQ ID NO: 8376 - DNA, 663 bp, Bacillus clausii
atggcaaacattcttgcagtcgatgacgaacaagacattcttgtgcttatcgaaaatattttgcagcgtgatggacataaagtcgatacgatcgcccaagcagacaaagtcgctcttaacgattttgctggttacgacctaattttgctcgatgtgatgatgccccatatcaatgggtttgagttatgcgaaaaaatccggcctattgttgattgcccaattctgtttttaacagcgaaggcagaggaaaccgcagtcgtagaagggtttacaagcggtggggacgactatatttcaaaaccgtttagcatacgagaactcagcgctagagtaaacgcccatttgcgccgagaaaaccgggaaaaacaccatactaaacgggtgatctcagggtttgtcttcgactttgacaataaagaagtgtatattaacaaccaaaagctaaacttgacaaaaaacgaatataaaatttgcgcctttttggcgcaaaacaaaggacgcacattttcaagggaccaaatttacgatgaaatttacgggttagacggcaatgccttgcatggcacgattactgaatttatccgcaccatccgcaaaaaatgcaaagaacacgaagtcgacccgattaaaacagtttggggaatcggatacaaatgggaatag

SEQ ID NO: 8377 - DNA, 585 bp, Bacillus clausii
ccacaatggacgagcaaattcaagattcatttgttctccttttagaagtcatgatggggtacgggcttgcttatcaagaacatcaaatattaaggaaccggcagcaagaacttgagtcagaaattgatgttgcagctagtatgcagcagacccttctcccgcaagaaaagccaaaaacagaatttcttgatgtcggtgttgtttgtgaaccagcaaagaaaatgagcggcgattattaccattatgtacatgaggatgacaaagggctgggcatggctattgccgatatcattggcaaaggcgtgccagcggctctttgcatgtctatgatcaaatatgcgatggacagtttgccatctgagcagcaactccaaccttcgcttttacttgagaacttaaaccgtgttgtcgcccaaaacgtcggagacagcatgtttattacaatgatgtacgggtattataacagaacgactggtgatttccactattcaggtgcaggccacgaaccaggttttttttacagcgtggccaacgacgcatttgaagaattgcacgccaaagggctcgtattaggcgtgtcccgcc

SEQ ID NO: 8378 - DNA, 665 bp, Bacillus clausii
ttgcttgttgtagatgatgaagagcggattcgccgcttgttgcgaatgtatttagaaagggaagagtaccaaattgaagaagcaagcaatggggaggaggcacttgaactcgcccttgcaaaagaatatgacttgattttgcttgatgtgatgatgcctgggatggacggcgttgagatgtgccaagagctccgtaagaaaaaagcgacgcctgtaatgatgttgacggccaagggagaagaagcaaaccgtgtgcaagggtttgaagtaggagccgacgattacattgtcaaaccgttcagcccccgggaagtggtgctccgtgtgaaagctttgttgcgtcgtgcgtctgctactaagtttttgcaaactgacacacagacaaaagatgtgctcgtgtttgggccactcacgattgacaatgatgcccatcgagtgaccgttgacaagacggaaattagcttgacgccaaaagaatatgaactgctcttttatttggcgcaatcacctgataaagtgttttctcgtgaacagctattaaaggatgtttggaactatgagttttttggcgacttgcgaacagtcgacacacacgtcaaacggttgcgcgaaaaactgaatcgcgtttctccagaagtagcagccattatttcaacccgtttggg

SEQ ID NO: 8379 - DNA, 427 bp, Bacillus clausii
atggaaacatataatatttacctagtggaagatgaagcgaatttatcagaggtattaaaggcgtatttgcaaaaggaaggttggaatgttaccgtttttctcgacggcaatgctgctattgaggcggtcccggataaaccgcatttgtgggtattggatattatgctgcctgggaccgacggctaccaagttttgaaagctattaaagagcaagaagatacgccagttatttttatttctgcacgtgaccaagacttagatcgtgtgctcggccttgagatgggcagcgatgattatttggcgaagccgtttttgccccaggaactaattatccgcgtaaaaaagctgcttaatcgtgtttacggtacgtcgtcagcagaatcgcaaaaaattgagctaaacaactacagcattgacccaatcggcc

SEQ ID NO: 8380 - DNA, 339 bp, Bacillus clausii
  misc_feature (1)...(339): n = A,T,C or G
ctatattgaacaagcgatgaaacttggtgtggacggctatttgnttaaagatgacccgattgatcaattgattgtagcgatccgccgcattgtagctggtgaacacgtcatctctccagcacttagcaacatgttgtttcgtttgcagccaaacccattaaatgaccgtgaacaagaaatgctcgggcgagtgcgcaatggcgaaagcacagaaatgatcgcctctgccatgcacctttccctcggaacagtccgcaactatttatcatctgcgatgcaaaaacttgaaacgactaaccgccacgacgcattgcggatcgcagaagagaaaggatggat

SEQ ID NO: 8381 - DNA, 390 bp, Bacillus clausii
aaatcatgattgtggaagatgatttgaccattcgtgatatggtaggggaaacattagaaaagtggggttttgaaaccgttaagatcgaagactttgaccaaatcatgcaggtatttcttaatcatgatcctcacctagtcatcatggatatcaatttgccatcgtttgacggattttactggtgtaataaaatcagagaaatttcaaaggtccctatgatctttctctcttcccgtgatacaccaatggatatagtgatgtcgataaacatgggaggagatgattatattcaaaaacctttccatatggatgtattgattgcaaaaattaatgcactccttcgcagaacgtattcctacatggaaacacagtctaagacaatcgaacatg

SEQ ID NO: 8382 - DNA, 933 bp, Bacillus clausii
aatcgctcccttatctcgtgttttcagctagcatcgctacaaggctgtcactcgtatttttaacagaaggtggattaagccaatatgcgatgatgatggctacagtcgaagcggcgcttagctttatcctgacaatgatctttattcaaagcataccgcttgtgacaggaaaaagaggtggacaagcactccgtaatgaagaaattatttgtttaattatcttgcttgcctctgtaatgacaggaacagtcggttggacgataaatgaggctgtgcttcagcatagctttgccagttatctcgttttagtgtttgcttttgttggcggggctgcaataggctcgaccgtcggagtggtgaccggcttgattttaagcttggcgagtttagcaagtctttatcagatgagcctgcttgcccctgcaggcttgttagaagggttgttaaaggaagggaaacggatcggcgtgtcacttggcttacttgtaggaacgctcttaattggcatgtatggccaagggggcgggcttggggcaagtgtgtcagaatctgccattgcgatcacgctatttttgctgacgccgaagagctggctgacgaaagtagcacgctatattcctgggacagttgagcattcccaggaacagcagcaatatttacggaaagtccgggacgcgacagcgggaaaggttgaacggttttcgtctttattccaaacgctatcgaacagctttcatacaccttctaaaaatgaggaagaagagcatgaccatgaggtcgatgtcctcctgagccgcgtgacagaaaaaacatgccaaacgtgcatgttgaaagaaaagtgctggatgcaaaattttaatgctacttatgattctatgaagcaaatggtccaggaaagtgaggcgcatggaacagttgtcgatccaaaattac

SEQ ID NO: 8383 - DNA, 684 bp, Bacillus clausii
ccaatctaggaggatgaggatggacaaacatattctcgtggtagatgatgaaaagtcgattgctgatatattaaaatttaacttggagaaggaaggctttgatgttacttgtgcttatgatgggaatgaagcattagagcgcgtcaaggaacggaagcctgatttaatgctccttgatattatgctcccttataaagatggcatggaagtttgccgtgaagtaaggaagcaatacgatttgccaattatcatgttaacggcaaaagactcggaaattgataaagtgcttggccttgagcttggcgctgatgactatgttatcaagccgtttagcacgcgggaactgttggcacgtgtaaaggcaaacttgcggcgccaacaagtcgcttctgacgatgcgccaacaacgcaaaaagaaattacaattggcgagctatcgattcttcctgaagcgtatcaagtaaaaaaacggggcgagccagttgatttaacgcaccgggagtttgagttaatccattatcttggcaagcatttagccaagtaatgacgcgggagcatttgctgcaaggcggtgtggggctatgattatttggcgatgtcgcacatagacgtaacagtgcggcgcttgcgtgaaaagtggaagacaaacccaagctatcccaaactggattatgacgagaaggg

SEQ ID NO: 8384 - DNA, 424 bp, Bacillus clausii
gtgatttcatgacaattgatcaggtgctcgaaaaagcgcgtgcgtatttgacaaaagacgatgttgtctttttggaaaaagcgtacgagtttgctgaaaaggcacacagtggtcagtaccgtaaatcgggagagccctatattttacacccagtccaagtagctggcattattgtcgggcttgaattagatccgaatacgattgccgccgcttttcttcatgatgtcgttgaagataccgaagcaacagtcgacgatttggaagaagcgtttaacgaggaagtcgctatgctagttgacggcgtaacaaaattaaagaagtttaaatataaatccaaagaggagcagcaagccgaaaaccaccggaaaatgcttatggccatggctaaagatatccgcgtcctcttgattaaactggcagaccg

SEQ ID NO: 8385 - DNA, 453 bp, Bacillus clausii
atgttaaaagagcttgaggaacaaatggatgttttgtttcaggtcggggtgagcctggcttacgatgcgatcacgctggctaaacaggcttgtctagaggcttgtactgccttggaggagagcggggaaacacaaaaaatttgtttgtacgaacagatggggtttgaacggatcatgacgaagctcaaaaatgatgacgatgttcaggcctttgccgagaacacattaaaaccgctagaatccgcggaccgctatgcaggcgaagcgttgcttcacacgctagaggtgtttctccgtgaaaatggcaaccattcaaaaacggcggaaaaattgtttgttcatcgacgtacgttaaaataccgtttagaaaaaatagaagagcggctaatggtcgatcttaatgacagtgaagttcgatttttgctttattttgttttaaaaataagaaaatag

SEQ ID NO: 8386 - DNA, 636 bp, Bacillus clausii
atggagactgtacaagcgatatttgaaaacagcaacgccgtgctttttatgtttgatggtgagttttttattgcctttatttatggaaaagacttaaggaaacaagttggcgcctttgccgagaaactgccaggtggtatccacatggccgcggggaatccttcatttgccgttgatggatgcgcccgggcttatgaacaggcgaaagcattgctggaattgaaaaagaggtttggcagcgagctatctgattgcttgttctattatgaagcaggggcgtacaaatatatacagccttatgaagacaaagcgatgatcgctggtgaccatccagcaattgagcagttgcgtgaatatgatgcagaaaatcaaacaagtctgttggaaacattggcgatgtatattgaaaaagacggacaccttaccgctgcagcgaaagcgcttcatgttcatcccaattccctccaataccgattaaagcgaattgccgagttgacgggcttacatttgcgtaacccagctgaacgaattggcttatatttagatttacagcgcaaaaaagcgcaactttcggtgaattccacaaatgggatagggaaaattagggtggatgccccaaagaaaaaaagaccgtaa

SEQ ID NO: 8387 - DNA, 276 bp, Bacillus clausii
  misc_feature (1)...(276): n = A,T,C or G
aaaagtggtgatcatgttggcttttgcatacgatcaatttttgtgtcattcgttttcctcccttgatcaatttgtggaagaattaggcgtcctgctgaaatgtcctgttacaatagaaaacagtcaccatcatttactggcctattcagagcatggagaaggaacagaccaagcccgagtgtccnccatcatcggccgtaaagtaccagcgccgttaantcaccgctttttggaaagatgggattatggcttcgtcaaatcnatcgtctgaaccga

SEQ ID NO: 8388 - DNA, 693 bp, Bacillus clausii
ttgtgcaagagtggcttgaagcaggggcgctgactgagcctttaaaacggcaagcagcggcccattcccttgatgtgcaaaccgaaaaacaaattgtcctgattgagacagggttggatgaaacgatccactggcgcggtttggcgcagtggcgtgaacagagaaaaggaatgattgccatcccgtgggaaagaaataatgttctgcttgtatgctcgccgcagacagaaactgcgcttaaagcgactgtccatacattggtggaaacgctcgacattggcgggagctggtggggaggcgccggcagggcgttgccgcctgatgagattaagaagagttacgcggaagcgcaagcggccttagcggcagcaagaaaaacaaaccgtttcgtgtttgaacatgagttgaagttggaactgtgtgtagaggcaattcctgctgatacaaaagcacgctttgttgaacgggttttaaaaaaagtcggcgatgaacaagagcttttagggacattggctgcttttttagagaacgaccaatcgttgaaacggacagcagaagcccttcatgttcatatcaacacactccattaccgttttcacaagcttaaacagcatacaggtttagatgtacgaaagagcgaggattttgttctgttttatttggcccatttgtttttggaggattctacaaaga

SEQ ID NO: 8389 - DNA, 690 bp, Bacillus clausii
  misc_feature (1)...(690): n = A,T,C or G
ttctttttttgccatggaagatcngctttgctgccattacccaagcagttaccgccaagcttgttgattcaaagcaggacgattggcaatttacccaaaaggtacagcaggaactcttgtctttaatgcttgctgggaaccacttgtctgctctagctgaacatgttgctggctatgctgccgtacccattgtcatcacggatgcccaagggcgaataaaagggaaaagccatggggctgaaccggtagcaggcctagttagtcaagtgtataaacaaatgcgcacaagcgaccaggaaagtgagcaccacccccttgaacgaaaaatccaaacgctccatacagatggcacagacgtccatatattgccgatcatccaagcaaatgagcaaattcaagggtatgtttttgccgtcaatagagataaaatggcttcaagcgacctagcgacagcctttatattgcttgaacatgccgggacagccgctgcattttggtttctgcaagagaacacagtgcaagaaacggaagcacgtatgcgcaatcatttcgtcgccgacttgtcccacggttcgattgaaacggaagcacaacttaaaacacgggctgaagcgctaggatatgaggtttccgttccatatatcgcgatagtaggaatgctgcacaatatggaagagctgtatagccgtt

SEQ ID NO: 8390 - DNA, 870 bp, Bacillus clausii
tgtctttccgattcgaacagcctgtgcacgaaaagggtacttaattgtgctcggctcagcgtcaaaaagtgattgcccgtttgcgcttgcaatcgaacaggcagccaacgtcctgtcgtttgagctgatgaagcttcatgcagctgagcaacaagcccggcttgcccaaaatagctttttttccgacttagtcgaagggcgccgccctctcgaaaaggagcacggcgaagcgtatcctttctctgccaacaaagaatatgtattcattgctgctcacttagataacgctagcgggttgccgactaacgaagaagcgcttaagcaacatgaagacctgtatagccttcttgtacggctgtttcgcgaacggtatccaactagtcatgtgttttggaagaatgatgtgtatgttgtcgttattgaaagtgaccgttcaaacaacgaagaagcaaagttggttgcggaaatagacaccgttcaacaagacatacaggcattcttccgctctggcgtatcgtttggcatctccagcttcgccagcttaagtgaagcggcaagcttatacaaggaagcgacggcggcccttcagtctggctaccgagaacatttgcaaagcttcatcaaaacgcaccgcgcccaagagctggctgacatgctgcaaatgattccgtctgagaagcttactgccttttgccaaaccgccttgcaaagcttagcaacaccagaatctcccgaccaagcggaactagcccgtacactgtccatctatattaatcataattgccaagtggcggaaaccgcaaaagtcatggcgatccatcgcaacacggtcatttaccgaatcaaaaaatgcgaggactgcttggctgt

SEQ ID NO: 8391 - DNA, 975 bp, Bacillus clausii
atgtgtgaaaaatactggcgcctgcgggagttgatttcaagcaaacagctgccgacgttgcagctatccatcctgcgggaaggcaagaatccgtgcgctgtctttccgattcgaacagcctgtgcacgaaaagggtacttaattgtgctcggctcagcgtcaaaaagtgattgcccgtttgcgcttgcaatcgaacaggcagccaacgtcctgtcgtttgagctgatgaagcttcatgcagctgagcaacaagcccggcttgcccaaaatagctttttttccgacttagtcgaagggcgccgccctctcgaaaaggagcacggcgaagcgtatcctttctctgccaacaaagaatatgtattcattgctgctcacttagataacgctagcgggttgccgactaacgaagaagcgcttaagcaacatgaagacctgtatagccttcttgtacggctgtttcgcgaacggtatccaactagtcatgtgttttggaagaatgatgtgtatgttgtcgttattgaaagtgaccgttcaaacaacgaagaagcaaagttggttgcggaaatagacaccgttcaacaagacatacaggcattcttccgctctggcgtatcgtttggcatctccagcttcgccagcttaagtgaagcggcaagcttatacaaggaagcgacggcggcccttcagtctggctaccgagaacatttgcaaagcttcatcaaaacgcaccgcgcccaagagctggctgacatgctgcaaatgattccgtctgagaagcttactgccttttgccaaaccgccttgcaaagcttagcaacaccagaatctcccgaccaagcggaactagcccgtacactgtccatctatattaatcataattgccaagtggcggaaaccgcaaaagtcatggcgatccatcgcaacacggtcatttaccgaatcaaaaaatgcgaggactgcttggctgtgatttaa

SEQ ID NO: 8392 - DNA, 276 bp, Bacillus clausii
  misc_feature (1)...(276): n = A,T,C or G
aagtggtgatcatgttggcttttgcatacgatcaatttttgtgtcattcgttttcctcccttgatcaatttgtggaagaattaggcgtcctgctgaaatgtcctgttacnatagaaaacagtcaccatcatttactggcctattcagagcatggagaaggaacagaccaagcccgagtgtccnccatcatcggccgtaaagtaccagcgccgttaantcaccgctttttggaaagatgggattatggcttcgtcaaatcnatcgtctgaaccgatt

SEQ ID NO: 8393 - DNA, 513 bp, Bacillus clausii
atgcaaatgaaagacttgttggcgttgcctgtctttgcaaaggcccgtctgctcgcaggcaaacgtgggctcgataagccgcttcgttctgccaatatgattcattcctttgatccaggtgcctacatggaaccccatcaattgctgctcgctgctactcttaaaaaaaggcatccgtattcccttgttgcctttgtccaggaactatcaaagcaaaattgcgcaggcctggtggtgcggactaaacgactagagaaaacgatccctgccgttgttattgacgcatgcaaccgtcttcagctgcctttgtttgaactaccagatacgattcattttagcgaattcgtccatcagttgacgcagtttcttttaaaagggcagacgacagaagctccatcaagcgttggagatccaccgccactttgccgatgtgattgtggctggcggaaatggcacatctgttgtcgtacaattggcccctatgcccaatgtgcccgcattgctgttaaatga

SEQ ID NO: 8394 - DNA, 222 bp, Bacillus clausii
aagaggctgtacttgtatatggaccaagccaatatccgtataaatttaacgaaacacacccgtttcatccccttcgtctcgaattgacgtactctctcttggaagagttgggggcggtgcaaaaccagccactcattcaacctagcgcagctacaaaggcggaattagagctgattcatgattctcgttttattgaagcggtcattgcaggcggcgagggac

SEQ ID NO: 8395 - DNA, 1006 bp, Bacillus clausii
atgaagattacattggcgcaagtaatggaattggacattatgaagcctgctatcattaagactgcacaagaacagttgccttaccgacaagtcgaatgggtgtcgattacggaagcaccagtggaaaactttatcaggcaaaatgagcttgtccttacgactggcatcggctgcacccaagagccgaaggcgttttattcctttgtgcaagatgtgattaagtcggaagcgtcggggcttgcggttgcgatcggccggtttgtgttcgaattgtccgaagatgtccgcgcccttgcagagaatgcgcagtttccgattctttttttgccatgggagatccgctttgctgacattacacaagcagttaccgccaagcttgttgattcaaagcaggacgattggcaatttacccaaaaggtacagcaggaactcttgtctttaatgcttgctgggaaccacttgtctgctctagctgaacatgttgctggctatgctgccgtacccattgtcatcacggatgcccaagggcgaataaaagggaaaagccatggggctgaaccggtagcaggcctagttagtcaagtgtataaacaaatgcgcacaagcgaccaggaaagtgagcaccacccccttgaacgaaaaatccaaacgctccatacagatggcacagacgtccatatattgccgatcatccaagcaaatgagcaaattcaagggtatgtttttgccgtcaatagagataaaatggcttcaagcgacctagcgacagcctttatattgcttgaacatgccgggacagccgctgcattttggtttctgcaagagaacacagtgcaagaaacggaagcacgtatgcgcaatcatttcgtcgccgacttgtcccacggttcgattgaaacggaagcacaacttaaaacacgggctgaagcgctaggatatgaggtttccgttccatatatcgcgatagtaggaatgctgcacaatatggaagagctgtatagccgtt

SEQ ID NO: 8396 - DNA, 76 bp, Bacillus clausii; identical to SEQ ID NO: 4361

SEQ ID NO: 8397 - DNA, 77 bp, Bacillus clausii
gggcctgtagctcagctggttagagcgcacgcctgataagcgtgaggtcggtggttcaagtccactcaggcccacca

SEQ ID NO: 8398 - DNA, 76 bp, Bacillus clausii
ggggccttagctcagctgggagagcgcctgctttgcacgcaggaggtcagcggttcgatcccgctaggctccactt

SEQ ID NO: 8399 - DNA, 33 bp, Bacillus clausii
ataaaggcgttagaatggggatcaaaaggtttg

SEQ ID NO: 8400 - DNA, 75 bp, Bacillus clausii
tccacagtagctcagtggtagagctatcggctgttaaccgatcggtcgcaggttcgaatcctgcctgtggagcca

SEQ ID NO: 8401 - DNA, 77 bp, Bacillus clausii; identical to SEQ ID NO: 4366

SEQ ID NO: 8402 - DNA, 74 bp, Bacillus clausii
ggcccgttggtcaagcggttaagacaccgccctttcacggcggtaacacgggttcgaatcccgtacgggtcacc

SEQ ID NO: 8403 - DNA, 60 bp, Bacillus clausii
tagctcagtcggtagagcaccaccatggtaaggtgggggtcagcggttcaagtgccgctt

SEQ ID NO: 8404 - DNA, 31 bp, Bacillus clausii
gcgggtgtagtttagtggtaaaacctcagcc

SEQ ID NO: 8405 - DNA, 76 bp, Bacillus clausii
gcggttgtggcgaagtggttaacgcaccggattgtggttccggcattcgtgggttcgattcccatcagccgcccca

SEQ ID NO: 8406 - DNA, 77 bp, Bacillus clausii; identical to SEQ ID NO: 8397

SEQ ID NO: 8407 - DNA, 84 bp, Bacillus clausii
  misc_feature (1)...(84): n = A,T,C or G
gcgggtgtggcggaattggcagacgcgctagaatcaggctctagtgtcttancggacgtgggggttcaagtcccttcacccgca

SEQ ID NO: 8408 - DNA, 85 bp, Bacillus clausii
gccggtgtggcggaattggcagacgcgcacgactcaaaatcgtgttccttcgggagtgtcggttcgaccccgaccaccggtatta

SEQ ID NO: 8409 - DNA, 76 bp, Bacillus clausii; identical to SEQ ID NO: 4374

SEQ ID NO: 8410 - DNA, 77 bp, Bacillus clausii
ggcggtgtagctcagctggctagagcgtacggttcatacccgtgaggtcgggggttcgatcccctccgccgctacca

SEQ ID NO: 8411 - DNA, 64 bp, Bacillus clausii
  misc_feature (1)...(64): n = A,T,C or G
cgccgggtggagcagtctggttagctcgtccggctcataacccgaangtccgcggttccaatcc

SEQ ID NO: 8412 - DNA, 75 bp, Bacillus clausii
ggacccttagctcagttggttagagcagtcggctcataaccgattggtcgtaggttcgagtcctacagggtccac

SEQ ID NO: 8413 - DNA, 76 bp, Bacillus clausii
ggctcggtagctcagttggtagagcaacggactgaaaatccgtgtgtcggcggttcgattccgtcccgagccacca

SEQ ID NO: 8414 - DNA, 61 bp, Bacillus clausii
agtagctcagtggtagagctatcggctgttaaccgatcggtcgcaggttcgaatcctgcct

SEQ ID NO: 8415 - DNA, 93 bp, Bacillus clausii
ggaggaatacccaagtccggctgaagggatcggtcttgaaaaccgacaggcgggtcacaccgcgcgggggttcgaatccctcttcctccgcca

SEQ ID NO: 8416 - DNA, 91 bp, Bacillus clausii
  misc_feature (1)...(91): n = A,T,C or G
ggagaagtacccaagtggctgaaggggctcccctgctaagggagtaggtcgtgtaagcggcgcgagggttcaaatccctccttntccgcca

SEQ ID NO: 8417 - DNA, 73 bp, Bacillus clausii
gccggtctagctcaattggtagagcaactgacttgtaatcagtaggttgggggttcaagtcctctggccggca

SEQ ID NO: 8418 - DNA, 76 bp, Bacillus clausii
ggaggattagctcagctgggagagcatctgccttacaagcagagggtcggcggttcgagcccgtcatcctccacca

SEQ ID NO: 8419 - DNA, 75 bp, Bacillus clausii; identical to SEQ ID NO: 8400

SEQ ID NO: 8420 - DNA, 77 bp, Bacillus clausii; identical to SEQ ID NO: 4366

SEQ ID NO: 8421 - DNA, 41 bp, Bacillus clausii
cgtctatagccccgtcaaggagcgtttctgcaaaaccttta

SEQ ID NO: 8422 - DNA, 73 bp, Bacillus clausii
gcctatggtgaaatgggatatcacacgagattccggttctcgcgttgtgggttcgaatcctgctaggcgcgtc

SEQ ID NO: 8423 - DNA, 72 bp, Bacillus clausii
ggcccgttggtcaagcggttaagacaccgccctttcacggcggtaacacgggttcgaatcccgtacgggtca

SEQ ID NO: 8424 - DNA, 60 bp, Bacillus clausii; identical to SEQ ID NO: 8403

SEQ ID NO: 8425 - DNA, 76 bp, Bacillus clausii; identical to SEQ ID NO: 8405

SEQ ID NO: 8426 - DNA, 82 bp, Bacillus clausii
gccggtgtggcggaattggcagacgcgcacgactcaaaatcgtgttccttcgggagtgtcggttcgaccccgaccaccggta

SEQ ID NO: 8427 - DNA, 83 bp, Bacillus clausii
gccggtgtggcggaattggcagacgcgcacgactcaaaatcgtgttccttcgggagtgtcggttcgaccccgaccaccggtat

SEQ ID NO: 8428 - DNA, 64 bp, Bacillus clausii; identical to SEQ ID NO: 8411
  misc_feature (1)...(64): n = A,T,C or G

SEQ ID NO: 8429 - DNA, 76 bp, Bacillus clausii; identical to SEQ ID NO: 8413

SEQ ID NO: 8430 - DNA, 94 bp, Bacillus clausii
ggagagctgtccgagttggccgaaggagcacgattggaaatcgtgtaggcggtgtaaaaccgtctcgagggttcgaatccctcgctctccgcca

SEQ ID NO: 8431 - DNA, 73 bp, Bacillus clausii; identical to SEQ ID NO: 8417

SEQ ID NO: 8432 - DNA, 68 bp, Bacillus clausii
aggcgcctatggtgaaatgggatatcacacgagattccggttctcgcgttgtgggttcgaatcctgct

SEQ ID NO: 8433 - DNA, 76 bp, Bacillus clausii; identical to SEQ ID NO: 8418

SEQ ID NO: 8434 - DNA, 33 bp, Bacillus clausii; identical to SEQ ID NO: 8399

SEQ ID NO: 8435 - DNA, 77 bp, Bacillus clausii; identical to SEQ ID NO: 4366

SEQ ID NO: 8436 - DNA, 31 bp, Bacillus clausii; identical to SEQ ID NO: 8404

SEQ ID NO: 8437 - DNA, 64 bp, Bacillus clausii; identical to SEQ ID NO: 8411
  misc_feature (1)...(64): n = A,T,C or G

SEQ ID NO: 8438 - DNA, 76 bp, Bacillus clausii; identical to SEQ ID NO: 4361

SEQ ID NO: 8439 - DNA, 33 bp, Bacillus clausii; identical to SEQ ID NO: 8399

SEQ ID NO: 8440 - DNA, 73 bp, Bacillus clausii
tccacagtagctcagtggtagagctatcggctgttaaccgatcggtcgcaggttcgaatcctgcctgtggagc

SEQ ID NO: 8441 - DNA, 60 bp, Bacillus clausii; identical to SEQ ID NO: 8403

SEQ ID NO: 8442 - DNA, 61 bp, Bacillus clausii; identical to SEQ ID NO: 8414

SEQ ID NO: 8443 - DNA, 75 bp, Bacillus clausii
gcttccatagctcagtcggtagagcaccaccatggtaaggtgggggtcagcggttcaagtgccgcttggaagctt

SEQ ID NO: 8444 - DNA, 76 bp, Bacillus clausii; identical to SEQ ID NO: 4361

SEQ ID NO: 8445 - DNA, 33 bp, Bacillus clausii; identical to SEQ ID NO: 8399

SEQ ID NO: 8446 - DNA, 60 bp, Bacillus clausii; identical to SEQ ID NO: 8403

SEQ ID NO: 8447 - DNA, 86 bp, Bacillus clausii
  misc_feature (1)...(86): n = A,T,C or G
gcgggtgtggcggaattggcagacgcgctagaatcaggctctagtgtcttancggacgtgggggttcaagtcccttcacccgcatt

SEQ ID NO: 8448 - DNA, 85 bp, Bacillus clausii; identical to SEQ ID NO: 8408

SEQ ID NO: 8449 - DNA, 76 bp, Bacillus clausii; identical to SEQ ID NO: 4374

SEQ ID NO: 8450 - DNA, 61 bp, Bacillus clausii; identical to SEQ ID NO: 8414

SEQ ID NO: 8451 - DNA, 73 bp, Bacillus clausii; identical to SEQ ID NO: 8417

SEQ ID NO: 8452 - DNA, 76 bp, Bacillus clausii; identical to SEQ ID NO: 8418

SEQ ID NO: 8453 - DNA, 76 bp, Bacillus clausii; identical to SEQ ID NO: 4361

SEQ ID NO: 8454 - DNA, 77 bp, Bacillus clausii; identical to SEQ ID NO: 8397

SEQ ID NO: 8455 - DNA, 75 bp, Bacillus clausii
gcggtgtagctcagctggctagagcgtacggttcatacccgtgaggtcgggggttcgatcccctccgccgctacc

SEQ ID NO: 8456 - DNA, 75 bp, Bacillus clausii; identical to SEQ ID NO: 8400

SEQ ID NO: 8457 - DNA, 68 bp, Bacillus clausii
tagctcagtggtagagctatcggctgttaaccgatcggtcgcaggttcgaatcctgcctgtggagcca

SEQ ID NO: 8458 - DNA, 72 bp, Bacillus clausii; identical to SEQ ID NO: 8423

SEQ ID NO: 8459 - DNA, 87 bp, Bacillus clausii
  misc_feature (1)...(87): n = A,T,C or G
gcgggtgtggcggaattggcagacgcgctagaatcaggctctagtgtcttancggacgtgggggttcaagtcccttcacccgcattt

SEQ ID NO: 8460 - DNA, 85 bp, Bacillus clausii
  misc_feature (1)...(85): n = A,T,C or G
gcgggtgtggcggaattggcagacgcgctagaatcaggctctagtgtcttancggacgtgggggttcaagtcccttcacccgcat

SEQ ID NO: 8461 - DNA, 76 bp, Bacillus clausii; identical to SEQ ID NO: 4374

SEQ ID NO: 8462 - DNA, 91 bp, Bacillus clausii; identical to SEQ ID NO: 8416
  misc_feature (1)...(91): n = A,T,C or G

SEQ ID NO: 8463 - DNA, 74 bp, Bacillus clausii
ggggccttagctcagctgggagagcgcaacgctggcagcgttgaggtcaggggttcgagccccctaggctccat

SEQ ID NO: 8464 - DNA, 72 bp, Bacillus clausii
ggctcggtagctcagttggtagagcaacggactgaaaatccgtgtgtcggcggttcgattccgtcccgagcc

SEQ ID NO: 8465 - DNA, 56 bp, Bacillus clausii
tggtcaagcggttaagacaccgccctttcacggcggtaacacgggttcgaatcccg

SEQ ID NO: 8466 - DNA, 74 bp, Bacillus clausii
gcctatggtgaaatgggatatcacacgagattccggttctcgcgttgtgggttcgaatcctgctaggcgcgtca

SEQ ID NO: 8467 - DNA, 74 bp, Bacillus clausii; identical to SEQ ID NO: 8402

SEQ ID NO: 8468 - DNA, 72 bp, Bacillus clausii; identical to SEQ ID NO: 8423

SEQ ID NO: 8469 - DNA, 31 bp, Bacillus clausii; identical to SEQ ID NO: 8404

SEQ ID NO: 8470 - DNA, 77 bp, Bacillus clausii; identical to SEQ ID NO: 8410

SEQ ID NO: 8471 - DNA, 93 bp, Bacillus clausii; identical to SEQ ID NO: 8415

SEQ ID NO: 8472 - DNA, 73 bp, Bacillus clausii; identical to SEQ ID NO: 8417

SEQ ID NO: 8473 - DNA, 76 bp, Bacillus clausii; identical to SEQ ID NO: 8418

SEQ ID NO: 8474 - DNA, 70 bp, Bacillus clausii
ccttagctcagctgggagagcgcaacgctggcagcgttgaggtcaggggttcgagccccctaggctccat

SEQ ID NO: 8475 - DNA, 77 bp, Bacillus clausii; identical to SEQ ID NO: 4366

SEQ ID NO: 8476 - DNA, 72 bp, Bacillus clausii; identical to SEQ ID NO: 8423

SEQ ID NO: 8477 - DNA, 76 bp, Bacillus clausii; identical to SEQ ID NO: 4374

SEQ ID NO: 8478 - DNA, 74 bp, Bacillus clausii
ggctcggtagctcagttggtagagcaacggactgaaaatccgtgtgtcggcggttcgattccgtcccgagccac

SEQ ID NO: 8479 - DNA, 1552 bp, Bacillus clausii
tttaacggagagtttgatcctggctcaggacgaacgctggcggcgtgcctaatacatgcaagtcgagcggacagaagggagcttgctcccggacgttagcggcggacgggtgagtaacacgtgggcaacctgccccttagactgggataactccgggaaaccggagctaataccggataatccctttctccacctggagagagggtgaaagatggcttcggctatcactaggggatgggcccgcggcgcattagctagttggtaaggtaacggcttaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgaggaaggccttcgggtcgtaaagctctgttgtgagggaagaagcggtaccgttcgaatagggcggtaccttgacggtacctcaccagaaagccacggctaactacgtgccagcagccgcggtaatacgtaggtggcaagcgttgtccggaattattgggcgtaaagcgcgcgcaggcggcttcttaagtctgatgtgaaatctcggggctcaaccccgagcggccattggaaactggggagcttgagtgcagaagaggagagtggaattccacgtgtagcggtgaaatgcgtagagatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccgtagtgccgaagttaacacattaagcactccgcctggggagtacggccgcaaggctgaaactcaaaggaattgacggggacccgcacaagcagtggagcatgtggtttaattcgaagcaacgcgaagaaccttaccaggtcttgacatcctttgaccacccaagagattgggcttccccttcgggggcaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaaaccgcgaggtgaagccaatcccataaagccattctcagttcggattgcaggctgcaactcgcctgcatgaagccggaattgctagtaatcgcggatcagcatgccgcggtgaatacgttcccgggtcttgtacacaccgcccgtcacaccacgagagtttgtaacacccgaagtcggtgaggcaaccttttggagccagccgcctaaggtgggacaaatgattggggtgaagtcgtaacaaggtagccgtatcggaaggtgcggctggatcacctcctttct

SEQ ID NO: 8480 - DNA, 2545 bp, Bacillus clausii
aacttcgtttcctccagagtggatcctgagtacggcgggacacgtgaaaccccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaactagtcagagcccgttaacgggtgatggcgtgccttttgtagaatgaaccggcgagttacggtatcgtgcaaggttaagctgatgaagcggagccgcagcgaaagcgagtctgaatagggcgcctaagtacgatgccgtagactcgaaaccgggtgatctacccatgtccagggtgaaggtcgggtaacaccgactggaggcccgaacccacgcaagttgaaaattgcggggatgaggtgtgggtaggggtgaaatgccaatcgaactcggaaatagctggttctccccgaaatagctttagggctagcctcgagtgatgagtcttggaggtagagcactgattggacgaggggtccccacaggattaccgaattcagtcaaactccgaatgccaatgactttaactcgggagtcagactgcgagtgctaagatccgtagtcaagagggaaacagcccagaccatcagctaaggtccccaagtatacgttaagtggaaaaggatgtggagttgcccagacaaccaggatgttggcttagaagcagccatcattgaaagagtgcgtaatagctcactggtcgagtgactctgcgccgaaaatgtaccggggctaaacgtatcaccgaagctatggcaatcccgtatgggattgggtaggggagcgttccaaggacagcgaagccagatcgtgaggactggtggagtgcttggaagtgagaatgccggtatgagtagcgaaaagataggtgagaatcctatccgtcgaaagcccaaggtttcctgaggaaggctcgtccgctcagggttagtcgggacctaagccgaggccgaaaggcgtaggcgatggacaacaggttgatattcctgtaccacctcgtattcgtttgaacgatggggggacgcagaaaggtagggtgagcgcgccgctggctgtgcgcgtcgaagcatgcaaggctggaacataggcaaatccgtgttccgtaaggctgagctgtgaccgtgaaggaccttcgggtccgaaatccctgatcctccgctgccgagaaaagcctctagtgagaatacaggtgcccgtaccgcaaaccgacacaggtaggcgagaagagaattctaagacgctcgggagaactctcgttaaggaactcggcaaaatgaccccgtaacttcgggagaaggggtgctctagtagggttaaccgcccgagagagccgcagtgaaaggatccaagcgactgtttagcaaaaacacaggtctctgcgaagccgtaaggcgaagtataggggctgacacctgcccggtgctggaaggttaagaggaagggtcatccctcacgggagaagctctgaattgaagccccagtaaacggcggccgtaactataacggtcctaaggtagcgaaattccttgtcgggtaagttccgacccgcacgaatggtgcaacgacttggatactgtctcaacgagagacccggtgaaattatagtacctgtgaagatgcaggttacccgcgacaggacggaaagaccccatggagctttactgtagcttgatagtgagtgttggtatcatctgtacaggataggtaggagccttggaaaccggagcgctagcttcggtggaggcgtcggtgggatactaccctgatggtgctggcattctaacctcgacccgtgatccgggccagggacattgtcaggtgggcagtttgactggggcggtcgcctcctaaacagtaacggaggcgcccaaaggttccctcagaatggttggaaatcattcgtagagtgcaaaggcagaagggagcttgactgcgagacctacaagtcgagcagggacgaaagtcgggcttagtgatccggcggtgccgtatggaagggccgtcgctcaacggataaaagctaccctggggataacaggcttatctcccccaagagtccacatcgacggggaggtttggcacctcgatgtcggctcgtcgcatcctggggctgaagtaggtcccaagggttgggctgttcgcccattaaagcggcacgcgagctgggttcagaacgtcgtgagacagttcggtccctatccgtcgcgggcgtaggaaatttgagaggagctgtccttagtacgagaggaccgggatggacataccgctggtgtaccagttgttccgccaggagcatcgctgggtagctacgtatggacgggataagtgctgaaagcatctaagcatgaagcccccctcaagatgagatttcccatggcgtaagccagtaagaccccttagagatgatgaggttgataggtcagaagtggaagcgtggcgacacgtggagcggactgatactaatcggtcgaggacttatcc

SEQ ID NO: 8481 - DNA, 109 bp, Bacillus clausii
ggtgacaatggcaaagaggtcacacccgttcccatgccgaacacggccgttaagctcttttgcgccgatggtagttggaggcttcctcctgcaagagtaggacgttgcc
